United States Patent 11,096,956 (ANTISENSE OLIGOMERS AND USES THEREOF) - sequence listing, part 11

SEQ ID NO: 150331 - RNA, 18 nt, Artificial Sequence
  Description of Artificial Sequence: Synthetic oligonucleotide
ugaacacuuaauugaugc

SEQ ID NO: 150332 - RNA, 18 nt, Artificial Sequence
  Description of Artificial Sequence: Synthetic oligonucleotide
uuuacugaacacuuaauu

SEQ ID NO: 150333 - RNA, 18 nt, Artificial Sequence
  Description of Artificial Sequence: Synthetic oligonucleotide
uagcauuuacugaacacu

SEQ ID NO: 150334 - RNA, 18 nt, Artificial Sequence
  Description of Artificial Sequence: Synthetic oligonucleotide
gcugcuagcauuuacuga

SEQ ID NO: 150335 - RNA, 18 nt, Artificial Sequence
  Description of Artificial Sequence: Synthetic oligonucleotide
gaacagcugcuagcauuu

SEQ ID NO: 150336 - RNA, 18 nt, Artificial Sequence
  Description of Artificial Sequence: Synthetic oligonucleotide
accaugaacagcugcuag

SEQ ID NO: 150337 - RNA, 18 nt, Artificial Sequence
  Description of Artificial Sequence: Synthetic oligonucleotide
caaaaaccaugaacagcu

SEQ ID NO: 150338 - RNA, 18 nt, Artificial Sequence
  Description of Artificial Sequence: Synthetic oligonucleotide
acaugcaaaaaccaugaa

SEQ ID NO: 150339 - RNA, 18 nt, Artificial Sequence
  Description of Artificial Sequence: Synthetic oligonucleotide
uauucacaugcaaaaacc

SEQ ID NO: 150340 - RNA, 18 nt, Artificial Sequence
  Description of Artificial Sequence: Synthetic oligonucleotide
cuuacuauucacaugcaa

SEQ ID NO: 150341 - RNA, 18 nt, Artificial Sequence
  Description of Artificial Sequence: Synthetic oligonucleotide
caacccuuacuauucaca

SEQ ID NO: 150342 - RNA, 18 nt, Artificial Sequence
  Description of Artificial Sequence: Synthetic oligonucleotide
uuugccaacccuuacuau

SEQ ID NO: 150343 - RNA, 18 nt, Artificial Sequence
  Description of Artificial Sequence: Synthetic oligonucleotide
aaaaguuugccaacccuu

SEQ ID NO: 150344 - RNA, 18 nt, Artificial Sequence
  Description of Artificial Sequence: Synthetic oligonucleotide
acggaaaaaguuugccaa

SEQ ID NO: 150345 - RNA, 18 nt, Artificial Sequence
  Description of Artificial Sequence: Synthetic oligonucleotide
ccuuuacggaaaaaguuu

SEQ ID NO: 150346 - RNA, 18 nt, Artificial Sequence
  Description of Artificial Sequence: Synthetic oligonucleotide
cuggcccuuuacggaaaa

SEQ ID NO: 150347 - RNA, 18 nt, Artificial Sequence
  Description of Artificial Sequence: Synthetic oligonucleotide
gccaacuggcccuuuacg

SEQ ID NO: 150348 - RNA, 18 nt, Artificial Sequence
  Description of Artificial Sequence: Synthetic oligonucleotide
uauuugccaacuggcccu

SEQ ID NO: 150349 - RNA, 18 nt, Artificial Sequence
  Description of Artificial Sequence: Synthetic oligonucleotide
uaaaauauuugccaacug

SEQ ID NO: 150350 - RNA, 18 nt, Artificial Sequence
  Description of Artificial Sequence: Synthetic oligonucleotide
aaaccuaaaauauuugcc

SEQ ID NO: 150351 - RNA, 18 nt, Artificial Sequence
  Description of Artificial Sequence: Synthetic oligonucleotide
ccauaaaaccuaaaauau

SEQ ID NO: 150352 - RNA, 18 nt, Artificial Sequence
  Description of Artificial Sequence: Synthetic oligonucleotide
augguccauaaaaccuaa

SEQ ID NO: 150353 - RNA, 18 nt, Artificial Sequence
  Description of Artificial Sequence: Synthetic oligonucleotide
acuguaugguccauaaaa

SEQ ID NO: 150354 - RNA, 18 nt, Artificial Sequence
  Description of Artificial Sequence: Synthetic oligonucleotide
caaagacuguauggucca

SEQ ID NO: 150355 - RNA, 18 nt, Artificial Sequence
  Description of Artificial Sequence: Synthetic oligonucleotide
ugugacaaagacuguaug

SEQ ID NO: 150356 - RNA, 18 nt, Artificial Sequence
  Description of Artificial Sequence: Synthetic oligonucleotide
gaggaugugacaaagacu

SEQ ID NO: 150357 - RNA, 18 nt, Artificial Sequence
  Description of Artificial Sequence: Synthetic oligonucleotide
auuaagaggaugugacaa

SEQ ID NO: 150358 - RNA, 18 nt, Artificial Sequence
  Description of Artificial Sequence: Synthetic oligonucleotide
guaguauuaagaggaugu

SEQ ID NO: 150359 - RNA, 18 nt, Artificial Sequence
  Description of Artificial Sequence: Synthetic oligonucleotide
ccaagguaguauuaagag

SEQ ID NO: 150360 - RNA, 18 nt, Artificial Sequence
  Description of Artificial Sequence: Synthetic oligonucleotide
auguuccaagguaguauu

SEQ ID NO: 150361 - RNA, 18 nt, Artificial Sequence
  Description of Artificial Sequence: Synthetic oligonucleotide
cuuucauguuccaaggua

SEQ ID NO: 150362 - RNA, 18 nt, Artificial Sequence
  Description of Artificial Sequence: Synthetic oligonucleotide
ggcugcuuucauguucca

SEQ ID NO: 150363 - RNA, 18 nt, Artificial Sequence
  Description of Artificial Sequence: Synthetic oligonucleotide
ccuguggcugcuuucaug

SEQ ID NO: 150364 - RNA, 18 nt, Artificial Sequence
  Description of Artificial Sequence: Synthetic oligonucleotide
aauugccuguggcugcuu

SEQ ID NO: 150365 - RNA, 18 nt, Artificial Sequence
  Description of Artificial Sequence: Synthetic oligonucleotide
uuacaaauugccuguggc

SEQ ID NO: 150366 - RNA, 18 nt, Artificial Sequence
  Description of Artificial Sequence: Synthetic oligonucleotide
uuaguuuacaaauugccu

SEQ ID NO: 150367 - RNA, 18 nt, Artificial Sequence
  Description of Artificial Sequence: Synthetic oligonucleotide
acucauuaguuuacaaau

SEQ ID NO: 150368 - RNA, 18 nt, Artificial Sequence
  Description of Artificial Sequence: Synthetic oligonucleotide
agcucacucauuaguuua

SEQ ID NO: 150369 - RNA, 18 nt, Artificial Sequence
  Description of Artificial Sequence: Synthetic oligonucleotide
acaucagcucacucauua

SEQ ID NO: 150370 - RNA, 18 nt, Artificial Sequence
  Description of Artificial Sequence: Synthetic oligonucleotide
cuaggacaucagcucacu

SEQ ID NO: 150371 - RNA, 18 nt, Artificial Sequence
  Description of Artificial Sequence: Synthetic oligonucleotide
gaaagcuaggacaucagc

SEQ ID NO: 150372 - RNA, 18 nt, Artificial Sequence
  Description of Artificial Sequence: Synthetic oligonucleotide
caauagaaagcuaggaca

SEQ ID NO: 150373 - RNA, 18 nt, Artificial Sequence
  Description of Artificial Sequence: Synthetic oligonucleotide
ggcagcaauagaaagcua

SEQ ID NO: 150374 - RNA, 18 nt, Artificial Sequence
  Description of Artificial Sequence: Synthetic oligonucleotide
gcgguggcagcaauagaa

SEQ ID NO: 150375 - RNA, 18 nt, Artificial Sequence
  Description of Artificial Sequence: Synthetic oligonucleotide
aauuugcgguggcagcaa

SEQ ID NO: 150376 - RNA, 18 nt, Artificial Sequence
  Description of Artificial Sequence: Synthetic oligonucleotide
uuaguaauuugcgguggc

SEQ ID NO: 150377 - RNA, 18 nt, Artificial Sequence
  Description of Artificial Sequence: Synthetic oligonucleotide
aaguuuuaguaauuugcg

SEQ ID NO: 150378 - RNA, 18 nt, Artificial Sequence
  Description of Artificial Sequence: Synthetic oligonucleotide
ucacuaaguuuuaguaau

SEQ ID NO: 150379 - RNA, 18 nt, Artificial Sequence
  Description of Artificial Sequence: Synthetic oligonucleotide
guaacucacuaaguuuua

SEQ ID NO: 150380 - RNA, 18 nt, Artificial Sequence
  Description of Artificial Sequence: Synthetic oligonucleotide
gucguguaacucacuaag

SEQ ID NO: 150381 - RNA, 18 nt, Artificial Sequence
  Description of Artificial Sequence: Synthetic oligonucleotide
ugugugucguguaacuca

SEQ ID NO: 150382 - RNA, 18 nt, Artificial Sequence
  Description of Artificial Sequence: Synthetic oligonucleotide
auagaugugugucgugua

SEQ ID NO: 150383 - RNA, 18 nt, Artificial Sequence
  Description of Artificial Sequence: Synthetic oligonucleotide
caucuguaauugcauguu

SEQ ID NO: 150384 - RNA, 18 nt, Artificial Sequence
  Description of Artificial Sequence: Synthetic oligonucleotide
aauuucaucuguaauugc

SEQ ID NO: 150385 - RNA, 18 nt, Artificial Sequence
  Description of Artificial Sequence: Synthetic oligonucleotide
ucagaaauuucaucugua

SEQ ID NO: 150386 - RNA, 18 nt, Artificial Sequence
  Description of Artificial Sequence: Synthetic oligonucleotide
cuuguucagaaauuucau

SEQ ID NO: 150387 - RNA, 18 nt, Artificial Sequence
  Description of Artificial Sequence: Synthetic oligonucleotide
ugggccuuguucagaaau

SEQ ID NO: 150388 - RNA, 18 nt, Artificial Sequence
  Description of Artificial Sequence: Synthetic oligonucleotide
ucauuugggccuuguuca

SEQ ID NO: 150389 - RNA, 18 nt, Artificial Sequence
  Description of Artificial Sequence: Synthetic oligonucleotide
uguauucauuugggccuu

SEQ ID NO: 150390 - RNA, 18 nt, Artificial Sequence
  Description of Artificial Sequence: Synthetic oligonucleotide
aauaauguauucauuugg

SEQ ID NO: 150391 - RNA, 18 nt, Artificial Sequence
  Description of Artificial Sequence: Synthetic oligonucleotide
ggaauaauaauguauuca

SEQ ID NO: 150392 - RNA, 18 nt, Artificial Sequence
  Description of Artificial Sequence: Synthetic oligonucleotide
guggaggaauaauaaugu

SEQ ID NO: 150393 - RNA, 18 nt, Artificial Sequence
  Description of Artificial Sequence: Synthetic oligonucleotide
acuugguggaggaauaau

SEQ ID NO: 150394 - RNA, 18 nt, Artificial Sequence
  Description of Artificial Sequence: Synthetic oligonucleotide
cagacacuugguggagga

SEQ ID NO: 150395 - RNA, 18 nt, Artificial Sequence
  Description of Artificial Sequence: Synthetic oligonucleotide
agcaucagacacuuggug

SEQ ID NO: 150396 - RNA, 18 nt, Artificial Sequence
  Description of Artificial Sequence: Synthetic oligonucleotide
auaauagcaucagacacu

SEQ ID NO: 150397 - RNA, 18 nt, Artificial Sequence
  Description of Artificial Sequence: Synthetic oligonucleotide
auuucauaauagcaucag

SEQ ID NO: 150398 - RNA, 18 nt, Artificial Sequence
  Description of Artificial Sequence: Synthetic oligonucleotide
gacaaauuucauaauagc

SEQ ID NO: 150399 - RNA, 18 nt, Artificial Sequence
  Description of Artificial Sequence: Synthetic oligonucleotide
aauuugacaaauuucaua

SEQ ID NO: 150400 - RNA, 18 nt, Artificial Sequence
  Description of Artificial Sequence: Synthetic oligonucleotide
cucagaauuugacaaauu

SEQ ID NO: 150401 - RNA, 18 nt, Artificial Sequence
  Description of Artificial Sequence: Synthetic oligonucleotide
ggaugcucagaauuugac

SEQ ID NO: 150402 - RNA, 18 nt, Artificial Sequence
  Description of Artificial Sequence: Synthetic oligonucleotide
gguugggaugcucagaau

SEQ ID NO: 150403 - RNA, 18 nt, Artificial Sequence
  Description of Artificial Sequence: Synthetic oligonucleotide
cuguugguugggaugcuc

SEQ ID NO: 150404 - RNA, 18 nt, Artificial Sequence
  Description of Artificial Sequence: Synthetic oligonucleotide
caguucuguugguuggga

SEQ ID NO: 150405 - RNA, 18 nt, Artificial Sequence
  Description of Artificial Sequence: Synthetic oligonucleotide
ugauucaguucuguuggu

SEQ ID NO: 150406 - RNA, 18 nt, Artificial Sequence
  Description of Artificial Sequence: Synthetic oligonucleotide
cuacuugauucaguucug

SEQ ID NO: 150407 - RNA, 18 nt, Artificial Sequence
  Description of Artificial Sequence: Synthetic oligonucleotide
uuacccuacuugauucag

SEQ ID NO: 150408 - RNA, 18 nt, Artificial Sequence
  Description of Artificial Sequence: Synthetic oligonucleotide
uuuccuuacccuacuuga

SEQ ID NO: 150409 - RNA, 18 nt, Artificial Sequence
  Description of Artificial Sequence: Synthetic oligonucleotide
aauacuuuccuuacccua

SEQ ID NO: 150410 - RNA, 18 nt, Artificial Sequence
  Description of Artificial Sequence: Synthetic oligonucleotide
gcuagaauacuuuccuua

SEQ ID NO: 150411 - RNA, 18 nt, Artificial Sequence
  Description of Artificial Sequence: Synthetic oligonucleotide
augcagcuagaauacuuu

SEQ ID NO: 150412 - RNA, 18 nt, Artificial Sequence
  Description of Artificial Sequence: Synthetic oligonucleotide
ucacaaugcagcuagaau

SEQ ID NO: 150413 - RNA, 18 nt, Artificial Sequence
  Description of Artificial Sequence: Synthetic oligonucleotide
gggugucacaaugcagcu

SEQ ID NO: 150414 - RNA, 18 nt, Artificial Sequence
  Description of Artificial Sequence: Synthetic oligonucleotide
ucuuugcugaaggcuggg

SEQ ID NO: 150415 - RNA, 18 nt, Artificial Sequence
  Description of Artificial Sequence: Synthetic oligonucleotide
ugcucuuugcugaaggcu

SEQ ID NO: 150416 - RNA, 18 nt, Artificial Sequence
  Description of Artificial Sequence: Synthetic oligonucleotide
augcaugcucuuugcuga

SEQ ID NO: 150417 - RNA, 18 nt, Artificial Sequence
  Description of Artificial Sequence: Synthetic oligonucleotide
uaaacaugcaugcucuuu

SEQ ID NO: 150418 - RNA, 18 nt, Artificial Sequence
  Description of Artificial Sequence: Synthetic oligonucleotide
ugugauaaacaugcaugc

SEQ ID NO: 150419 - RNA, 18 nt, Artificial Sequence
  Description of Artificial Sequence: Synthetic oligonucleotide
cuuacugugauaaacaug

SEQ ID NO: 150420 - RNA, 18 nt, Artificial Sequence
  Description of Artificial Sequence: Synthetic oligonucleotide
uguggcuuacugugauaa

SEQ ID NO: 150421 - RNA, 18 nt, Artificial Sequence
  Description of Artificial Sequence: Synthetic oligonucleotide
aaagguguggcuuacugu

SEQ ID NO: 150422 - RNA, 18 nt, Artificial Sequence
  Description of Artificial Sequence: Synthetic oligonucleotide
acuuaaaagguguggcuu

SEQ ID NO: 150423 - RNA, 18 nt, Artificial Sequence
  Description of Artificial Sequence: Synthetic oligonucleotide
cuaaaacuuaaaaggugu

SEQ ID NO: 150424 - RNA, 18 nt, Artificial Sequence
  Description of Artificial Sequence: Synthetic oligonucleotide
aaaugcuaaaacuuaaaa

SEQ ID NO: 150425 - RNA, 18 nt, Artificial Sequence
  Description of Artificial Sequence: Synthetic oligonucleotide
agaaaaaaugcuaaaacu

SEQ ID NO: 150426 - RNA, 18 nt, Artificial Sequence
  Description of Artificial Sequence: Synthetic oligonucleotide
gccaaagaaaaaaugcua

SEQ ID NO: 150427 - RNA, 18 nt, Artificial Sequence
  Description of Artificial Sequence: Synthetic oligonucleotide
uauuagccaaagaaaaaa

SEQ ID NO: 150428 - RNA, 18 nt, Artificial Sequence
  Description of Artificial Sequence: Synthetic oligonucleotide
caaauuauuagccaaaga

SEQ ID NO: 150429 - RNA, 18 nt, Artificial Sequence
  Description of Artificial Sequence: Synthetic oligonucleotide
caagacaaauuauuagcc

SEQ ID NO: 150430 - RNA, 18 nt, Artificial Sequence
  Description of Artificial Sequence: Synthetic oligonucleotide
uuaaacaagacaaauuau

SEQ ID NO: 150431 - RNA, 18 nt, Artificial Sequence
  Description of Artificial Sequence: Synthetic oligonucleotide
uguauuuaaacaagacaa

SEQ ID NO: 150432 - RNA, 18 nt, Artificial Sequence
  Description of Artificial Sequence: Synthetic oligonucleotide
agaaguguauuuaaacaa

SEQ ID NO: 150433 - RNA, 18 nt, Artificial Sequence
  Description of Artificial Sequence: Synthetic oligonucleotide
aucaaagaaguguauuua

SEQ ID NO: 150434 - RNA, 18 nt, Artificial Sequence
  Description of Artificial Sequence: Synthetic oligonucleotide
uguauaucaaagaagugu

SEQ ID NO: 150435 - RNA, 18 nt, Artificial Sequence
  Description of Artificial Sequence: Synthetic oligonucleotide
cuaauuguauaucaaaga

SEQ ID NO: 150436 - RNA, 18 nt, Artificial Sequence
  Description of Artificial Sequence: Synthetic oligonucleotide
auacccuaauuguauauc

SEQ ID NO: 150437 - RNA, 18 nt, Artificial Sequence
  Description of Artificial Sequence: Synthetic oligonucleotide
aagguauacccuaauugu

SEQ ID NO: 150438 - RNA, 18 nt, Artificial Sequence
  Description of Artificial Sequence: Synthetic oligonucleotide
aaaaaaagguauacccua

SEQ ID NO: 150439 - RNA, 18 nt, Artificial Sequence
  Description of Artificial Sequence: Synthetic oligonucleotide
aaaaaaaaaaaagguaua

SEQ ID NO: 150440 - RNA, 18 nt, Artificial Sequence
  Description of Artificial Sequence: Synthetic oligonucleotide
aaaaaaaaaaaaaaaaag

SEQ ID NO: 150441 - RNA, 18 nt, Artificial Sequence
  Description of Artificial Sequence: Synthetic oligonucleotide
aaaaaaaaaaaaaaaaaa

SEQ ID NO: 150442 - RNA, 18 nt, Artificial Sequence
  Description of Artificial Sequence: Synthetic oligonucleotide
aaaaaaaaaaaaaaaaaa

SEQ ID NO: 150443 - RNA, 18 nt, Artificial Sequence
  Description of Artificial Sequence: Synthetic oligonucleotide
aaaaaaaaaaaaaaaaaa

SEQ ID NO: 150444 - RNA, 18 nt, Artificial Sequence
  Description of Artificial Sequence: Synthetic oligonucleotide
aaaaaaaaaaaaaaaaaa

SEQ ID NO: 150445 - RNA, 18 nt, Artificial Sequence
  Description of Artificial Sequence: Synthetic oligonucleotide
aaaaaaaaaaaaaaaaaa

SEQ ID NO: 150446 - RNA, 18 nt, Artificial Sequence
  Description of Artificial Sequence: Synthetic oligonucleotide
gguaaaaaaaaaaaaaaa

SEQ ID NO: 150447 - RNA, 18 nt, Artificial Sequence
  Description of Artificial Sequence: Synthetic oligonucleotide
gucuugguaaaaaaaaaa

SEQ ID NO: 150448 - RNA, 18 nt, Artificial Sequence
  Description of Artificial Sequence: Synthetic oligonucleotide
uuuuggucuugguaaaaa

SEQ ID NO: 150449 - RNA, 18 nt, Artificial Sequence
  Description of Artificial Sequence: Synthetic oligonucleotide
ggcuguuuuggucuuggu

SEQ ID NO: 150450 - RNA, 18 nt, Artificial Sequence
  Description of Artificial Sequence: Synthetic oligonucleotide
gaaauggcuguuuugguc

SEQ ID NO: 150451 - RNA, 18 nt, Artificial Sequence
  Description of Artificial Sequence: Synthetic oligonucleotide
aaguugaaauggcuguuu

SEQ ID NO: 150452 - RNA, 18 nt, Artificial Sequence
  Description of Artificial Sequence: Synthetic oligonucleotide
cagaaaaguugaaauggc

SEQ ID NO: 150453 - RNA, 18 nt, Artificial Sequence
  Description of Artificial Sequence: Synthetic oligonucleotide
ucuugcagaaaaguugaa

SEQ ID NO: 150454 - RNA, 18 nt, Artificial Sequence
  Description of Artificial Sequence: Synthetic oligonucleotide
accauucuugcagaaaag

SEQ ID NO: 150455 - RNA, 18 nt, Artificial Sequence
  Description of Artificial Sequence: Synthetic oligonucleotide
uaagcaccauucuugcag

SEQ ID NO: 150456 - RNA, 18 nt, Artificial Sequence
  Description of Artificial Sequence: Synthetic oligonucleotide
agccauaagcaccauucu

SEQ ID NO: 150457 - RNA, 18 nt, Artificial Sequence
  Description of Artificial Sequence: Synthetic oligonucleotide
guagaagccauaagcacc

SEQ ID NO: 150458 - RNA, 18 nt, Artificial Sequence
  Description of Artificial Sequence: Synthetic oligonucleotide
guaacguagaagccauaa

SEQ ID NO: 150459 - RNA, 18 nt, Artificial Sequence
  Description of Artificial Sequence: Synthetic oligonucleotide
uuccgguaacguagaagc

SEQ ID NO: 150460 - RNA, 18 nt, Artificial Sequence
  Description of Artificial Sequence: Synthetic oligonucleotide
uugcuuuccgguaacgua

SEQ ID NO: 150461 - RNA, 18 nt, Artificial Sequence
  Description of Artificial Sequence: Synthetic oligonucleotide
gaaguuugcuuuccggua

SEQ ID NO: 150462 - RNA, 18 nt, Artificial Sequence
  Description of Artificial Sequence: Synthetic oligonucleotide
uguuugaaguuugcuuuc

SEQ ID NO: 150463 - RNA, 18 nt, Artificial Sequence
  Description of Artificial Sequence: Synthetic oligonucleotide
ugugguguuugaaguuug

SEQ ID NO: 150464 - RNA, 18 nt, Artificial Sequence
  Description of Artificial Sequence: Synthetic oligonucleotide
uauggugugguguuugaa

SEQ ID NO: 150465 - RNA, 18 nt, Artificial Sequence
  Description of Artificial Sequence: Synthetic oligonucleotide
uguuguaugguguggugu

SEQ ID NO: 150466 - RNA, 18 nt, Artificial Sequence
  Description of Artificial Sequence: Synthetic oligonucleotide
uaagcuguuguauggugu

SEQ ID NO: 150467 - RNA, 18 nt, Artificial Sequence
  Description of Artificial Sequence: Synthetic oligonucleotide
cuuuauaagcuguuguau

SEQ ID NO: 150468 - RNA, 18 nt, Artificial Sequence
  Description of Artificial Sequence: Synthetic oligonucleotide
auauucuuuauaagcugu

SEQ ID NO: 150469 - RNA, 18 nt, Artificial Sequence
  Description of Artificial Sequence: Synthetic oligonucleotide
ccuaaauauucuuuauaa

SEQ ID NO: 150470 - RNA, 18 nt, Artificial Sequence
  Description of Artificial Sequence: Synthetic oligonucleotide
cugggccuaaauauucuu

SEQ ID NO: 150471 - RNA, 18 nt, Artificial Sequence
  Description of Artificial Sequence: Synthetic oligonucleotide
aacaccugggccuaaaua

SEQ ID NO: 150472 - RNA, 18 nt, Artificial Sequence
  Description of Artificial Sequence: Synthetic oligonucleotide
guaucaacaccugggccu

SEQ ID NO: 150473 - RNA, 18 nt, Artificial Sequence
  Description of Artificial Sequence: Synthetic oligonucleotide
aaaaaguaucaacaccug

SEQ ID NO: 150474 - RNA, 18 nt, Artificial Sequence
  Description of Artificial Sequence: Synthetic oligonucleotide
agaagaaaaaguaucaac

SEQ ID NO: 150475 - RNA, 18 nt, Artificial Sequence
  Description of Artificial Sequence: Synthetic oligonucleotide
uuugcagaagaaaaagua

SEQ ID NO: 150476 - RNA, 18 nt, Artificial Sequence
  Description of Artificial Sequence: Synthetic oligonucleotide
acaauuuugcagaagaaa

SEQ ID NO: 150477 - RNA, 18 nt, Artificial Sequence
  Description of Artificial Sequence: Synthetic oligonucleotide
cuggaacaauuuugcaga

SEQ ID NO: 150478 - RNA, 18 nt, Artificial Sequence
  Description of Artificial Sequence: Synthetic oligonucleotide
agcuucuggaacaauuuu

SEQ ID NO: 150479 - RNA, 18 nt, Artificial Sequence
  Description of Artificial Sequence: Synthetic oligonucleotide
uguuagcaaauaccacca

SEQ ID NO: 150480 - RNA, 18 nt, Artificial Sequence
  Description of Artificial Sequence: Synthetic oligonucleotide
uaugauguuagcaaauac

SEQ ID NO: 150481 - RNA, 18 nt, Artificial Sequence
  Description of Artificial Sequence: Synthetic oligonucleotide
uuggauaugauguuagca

SEQ ID NO: 150482 - RNA, 18 nt, Artificial Sequence
  Description of Artificial Sequence: Synthetic oligonucleotide
cugaguuggauaugaugu

SEQ ID NO: 150483 - RNA, 18 nt, Artificial Sequence
  Description of Artificial Sequence: Synthetic oligonucleotide
cuucccugaguuggauau

SEQ ID NO: 150484 - RNA, 18 nt, Artificial Sequence
  Description of Artificial Sequence: Synthetic oligonucleotide
guccgcuucccugaguug

SEQ ID NO: 150485 - RNA, 18 nt, Artificial Sequence
  Description of Artificial Sequence: Synthetic oligonucleotide
acucaguccgcuucccug

SEQ ID NO: 150486 - RNA, 18 nt, Artificial Sequence
  Description of Artificial Sequence: Synthetic oligonucleotide
ccagcacucaguccgcuu

SEQ ID NO: 150487 - RNA, 18 nt, Artificial Sequence
  Description of Artificial Sequence: Synthetic oligonucleotide
ggaucccagcacucaguc

SEQ ID NO: 150488 - RNA, 18 nt, Artificial Sequence
  Description of Artificial Sequence: Synthetic oligonucleotide
gccuuggaucccagcacu

SEQ ID NO: 150489 - RNA, 18 nt, Artificial Sequence
  Description of Artificial Sequence: Synthetic oligonucleotide
agaaugccuuggauccca

SEQ ID NO: 150490 - RNA, 18 nt, Artificial Sequence
  Description of Artificial Sequence: Synthetic oligonucleotide
ccuguagaaugccuugga

SEQ ID NO: 150491 - RNA, 18 nt, Artificial Sequence
  Description of Artificial Sequence: Synthetic oligonucleotide
ugaacccuguagaaugcc

SEQ ID NO: 150492 - RNA, 18 nt, Artificial Sequence
  Description of Artificial Sequence: Synthetic oligonucleotide
agcagugaacccuguaga

SEQ ID NO: 150493 - RNA, 18 nt, Artificial Sequence
  Description of Artificial Sequence: Synthetic oligonucleotide
aaaccagcagugaacccu

SEQ ID NO: 150494 - RNA, 18 nt, Artificial Sequence
  Description of Artificial Sequence: Synthetic oligonucleotide
aguguaaaccagcaguga

SEQ ID NO: 150495 - RNA, 18 nt, Artificial Sequence
  Description of Artificial Sequence: Synthetic oligonucleotide
ggugaaguguaaaccagc

SEQ ID NO: 150496 - RNA, 18 nt, Artificial Sequence
  Description of Artificial Sequence: Synthetic oligonucleotide
acacaggugaaguguaaa

SEQ ID NO: 150497 - RNA, 18 nt, Artificial Sequence
  Description of Artificial Sequence: Synthetic oligonucleotide
ugcugacacaggugaagu

SEQ ID NO: 150498 - RNA, 18 nt, Artificial Sequence
  Description of Artificial Sequence: Synthetic oligonucleotide
gauggugcugacacaggu

SEQ ID NO: 150499 - RNA, 18 nt, Artificial Sequence
  Description of Artificial Sequence: Synthetic oligonucleotide
cugaagauggugcugaca

SEQ ID NO: 150500 - RNA, 18 nt, Artificial Sequence
  Description of Artificial Sequence: Synthetic oligonucleotide
agcaccugaagauggugc

SEQ ID NO: 150501 - RNA, 18 nt, Artificial Sequence
  Description of Artificial Sequence: Synthetic oligonucleotide
uucuaagcaccugaagau

SEQ ID NO: 150502 - RNA, 18 nt, Artificial Sequence
  Description of Artificial Sequence: Synthetic oligonucleotide
ggccauucuaagcaccug

SEQ ID NO: 150503 - RNA, 18 nt, Artificial Sequence
  Description of Artificial Sequence: Synthetic oligonucleotide
ucccaggccauucuaagc

SEQ ID NO: 150504 - RNA, 18 nt, Artificial Sequence
  Description of Artificial Sequence: Synthetic oligonucleotide
caggcucccaggccauuc

SEQ ID NO: 150505 - RNA, 18 nt, Artificial Sequence
  Description of Artificial Sequence: Synthetic oligonucleotide
cagaacaggcucccaggc

SEQ ID NO: 150506 - RNA, 18 nt, Artificial Sequence
  Description of Artificial Sequence: Synthetic oligonucleotide
caagacagaacaggcucc

SEQ ID NO: 150507 - RNA, 18 nt, Artificial Sequence
  Description of Artificial Sequence: Synthetic oligonucleotide
agaugcaagacagaacag

SEQ ID NO: 150508 - RNA, 18 nt, Artificial Sequence
  Description of Artificial Sequence: Synthetic oligonucleotide
auggaagaugcaagacag

SEQ ID NO: 150509 - RNA, 18 nt, Artificial Sequence
  Description of Artificial Sequence: Synthetic oligonucleotide
augucauggaagaugcaa

SEQ ID NO: 150510 - RNA, 18 nt, Artificial Sequence
  Description of Artificial Sequence: Synthetic oligonucleotide
cuuucaugucauggaaga

SEQ ID NO: 150511 - RNA, 18 nt, Artificial Sequence
  Description of Artificial Sequence: Synthetic oligonucleotide
ccucccuuucaugucaug

SEQ ID NO: 150512 - RNA, 18 nt, Artificial Sequence
  Description of Artificial Sequence: Synthetic oligonucleotide
gccagccucccuuucaug

SEQ ID NO: 150513 - RNA, 18 nt, Artificial Sequence
  Description of Artificial Sequence: Synthetic oligonucleotide
caagugccagccucccuu

SEQ ID NO: 150514 - RNA, 18 nt, Artificial Sequence
  Description of Artificial Sequence: Synthetic oligonucleotide
acugacaagugccagccu

SEQ ID NO: 150515 - RNA, 18 nt, Artificial Sequence
  Description of Artificial Sequence: Synthetic oligonucleotide
accugacugacaagugcc

SEQ ID NO: 150516 - RNA, 18 nt, Artificial Sequence
  Description of Artificial Sequence: Synthetic oligonucleotide
ccucuaccugacugacaa

SEQ ID NO: 150517 - RNA, 18 nt, Artificial Sequence
  Description of Artificial Sequence: Synthetic oligonucleotide
uguaaccucuaccugacu

SEQ ID NO: 150518 - RNA, 18 nt, Artificial Sequence
  Description of Artificial Sequence: Synthetic oligonucleotide
cgguuuguaaccucuacc

SEQ ID NO: 150519 - RNA, 18 nt, Artificial Sequence
  Description of Artificial Sequence: Synthetic oligonucleotide
ugaaacgguuuguaaccu

SEQ ID NO: 150520 - RNA, 18 nt, Artificial Sequence
  Description of Artificial Sequence: Synthetic oligonucleotide
gggccugaaacgguuugu

SEQ ID NO: 150521 - RNA, 18 nt, Artificial Sequence
  Description of Artificial Sequence: Synthetic oligonucleotide
aggcagggccugaaacgg

SEQ ID NO: 150522 - RNA, 18 nt, Artificial Sequence
  Description of Artificial Sequence: Synthetic oligonucleotide
gugguaggcagggccuga

SEQ ID NO: 150523 - RNA, 18 nt, Artificial Sequence
  Description of Artificial Sequence: Synthetic oligonucleotide
ugaaugugguaggcaggg

SEQ ID NO: 150524 - RNA, 18 nt, Artificial Sequence
  Description of Artificial Sequence: Synthetic oligonucleotide
aacagugaaugugguagg

SEQ ID NO: 150525 - RNA, 18 nt, Artificial Sequence
  Description of Artificial Sequence: Synthetic oligonucleotide
auucaaacagugaaugug

SEQ ID NO: 150526 - RNA, 18 nt, Artificial Sequence
  Description of Artificial Sequence: Synthetic oligonucleotide
uaaagauucaaacaguga

SEQ ID NO: 150527 - RNA, 18 nt, Artificial Sequence
  Description of Artificial Sequence: Synthetic oligonucleotide
ggaauuaaagauucaaac

SEQ ID NO: 150528 - RNA, 18 nt, Artificial Sequence
  Description of Artificial Sequence: Synthetic oligonucleotide
ucuugggaauuaaagauu

SEQ ID NO: 150529 - RNA, 18 nt, Artificial Sequence
  Description of Artificial Sequence: Synthetic oligonucleotide
cuuauucuugggaauuaa

SEQ ID NO: 150530 - RNA, 18 nt, Artificial Sequence
  Description of Artificial Sequence: Synthetic oligonucleotide
guaaacuuauucuuggga

SEQ ID NO: 150531 - RNA, 18 nt, Artificial Sequence
  Description of Artificial Sequence: Synthetic oligonucleotide
gaaauguaaacuuauucu

SEQ ID NO: 150532 - RNA, 18 nt, Artificial Sequence
  Description of Artificial Sequence: Synthetic oligonucleotide
auugugaaauguaaacuu

SEQ ID NO: 150533 - RNA, 18 nt, Artificial Sequence
  Description of Artificial Sequence: Synthetic oligonucleotide
cauucauugugaaaugua

SEQ ID NO: 150534 - RNA, 18 nt, Artificial Sequence
  Description of Artificial Sequence: Synthetic oligonucleotide
uaggucauucauugugaa

SEQ ID NO: 150535 - RNA, 18 nt, Artificial Sequence
  Description of Artificial Sequence: Synthetic oligonucleotide
uguuguaggucauucauu

SEQ ID NO: 150536 - RNA, 18 nt, Artificial Sequence
  Description of Artificial Sequence: Synthetic oligonucleotide
uuagcuguuguaggucau

SEQ ID NO: 150537 - RNA, 18 nt, Artificial Sequence
  Description of Artificial Sequence: Synthetic oligonucleotide
aaaauuuagcuguuguag

SEQ ID NO: 150538 - RNA, 18 nt, Artificial Sequence
  Description of Artificial Sequence: Synthetic oligonucleotide
cccagaaaauuuagcugu

SEQ ID NO: 150539 - RNA, 18 nt, Artificial Sequence
  Description of Artificial Sequence: Synthetic oligonucleotide
ccagccccagaaaauuua

SEQ ID NO: 150540 - RNA, 18 nt, Artificial Sequence
  Description of Artificial Sequence: Synthetic oligonucleotide
uacucccagccccagaaa

SEQ ID NO: 150541 - RNA, 18 nt, Artificial Sequence
  Description of Artificial Sequence: Synthetic oligonucleotide
aguauuacucccagcccc

SEQ ID NO: 150542 - RNA, 18 nt, Artificial Sequence
  Description of Artificial Sequence: Synthetic oligonucleotide
uugucaguauuacuccca

SEQ ID NO: 150543 - RNA, 18 nt, Artificial Sequence
  Description of Artificial Sequence: Synthetic oligonucleotide
auggauugucaguauuac

SEQ ID NO: 150544 - RNA, 18 nt, Artificial Sequence
  Description of Artificial Sequence: Synthetic oligonucleotide
aguaaauggauugucagu

SEQ ID NO: 150545 - RNA, 18 nt, Artificial Sequence
  Description of Artificial Sequence: Synthetic oligonucleotide
gcuacaguaaauggauug

SEQ ID NO: 150546 - RNA, 18 nt, Artificial Sequence
  Description of Artificial Sequence: Synthetic oligonucleotide
gcagagcuacaguaaaug

SEQ ID NO: 150547 - RNA, 18 nt, Artificial Sequence
  Description of Artificial Sequence: Synthetic oligonucleotide
auuaagcagagcuacagu

SEQ ID NO: 150548 - RNA, 18 nt, Artificial Sequence
  Description of Artificial Sequence: Synthetic oligonucleotide
aguacauuaagcagagcu

SEQ ID NO: 150549 - RNA, 18 nt, Artificial Sequence
  Description of Artificial Sequence: Synthetic oligonucleotide
uaaguaguacauuaagca

SEQ ID NO: 150550 - RNA, 18 nt, Artificial Sequence
  Description of Artificial Sequence: Synthetic oligonucleotide
uuuccuaaguaguacauu

SEQ ID NO: 150551 - RNA, 18 nt, Artificial Sequence
  Description of Artificial Sequence: Synthetic oligonucleotide
gacauuuuccuaaguagu

SEQ ID NO: 150552 - RNA, 18 nt, Artificial Sequence
  Description of Artificial Sequence: Synthetic oligonucleotide
gcagggacauuuuccuaa

SEQ ID NO: 150553 - RNA, 18 nt, Artificial Sequence
  Description of Artificial Sequence: Synthetic oligonucleotide
auuaagcagggacauuuu

SEQ ID NO: 150554 - RNA, 18 nt, Artificial Sequence
  Description of Artificial Sequence: Synthetic oligonucleotide
acauuauuaagcagggac

SEQ ID NO: 150555 - RNA, 18 nt, Artificial Sequence
  Description of Artificial Sequence: Synthetic oligonucleotide
ggcuuacauuauuaagca

SEQ ID NO: 150556 - RNA, 18 nt, Artificial Sequence
  Description of Artificial Sequence: Synthetic oligonucleotide
agcuuggcuuacauuauu

SEQ ID NO: 150557 - RNA, 18 nt, Artificial Sequence
  Description of Artificial Sequence: Synthetic oligonucleotide
cauuuagcuuggcuuaca

SEQ ID NO: 150558 - RNA, 18 nt, Artificial Sequence
  Description of Artificial Sequence: Synthetic oligonucleotide
accaucauuuagcuuggc

SEQ ID NO: 150559 - RNA, 18 nt, Artificial Sequence
  Description of Artificial Sequence: Synthetic oligonucleotide
cuuuaaccaucauuuagc

SEQ ID NO: 150560 - RNA, 18 nt, Artificial Sequence
  Description of Artificial Sequence: Synthetic oligonucleotide
gauaacuuuaaccaucau

SEQ ID NO: 150561 - RNA, 18 nt, Artificial Sequence
  Description of Artificial Sequence: Synthetic oligonucleotide
ggccugauaacuuuaacc

SEQ ID NO: 150562 - RNA, 18 nt, Artificial Sequence
  Description of Artificial Sequence: Synthetic oligonucleotide
ugggaggccugauaacuu

SEQ ID NO: 150563 - RNA, 18 nt, Artificial Sequence
  Description of Artificial Sequence: Synthetic oligonucleotide
uuucaugggaggccugau

SEQ ID NO: 150564 - RNA, 18 nt, Artificial Sequence
  Description of Artificial Sequence: Synthetic oligonucleotide
cgcaauuucaugggaggc

SEQ ID NO: 150565 - RNA, 18 nt, Artificial Sequence
  Description of Artificial Sequence: Synthetic oligonucleotide
aagaacgcaauuucaugg

SEQ ID NO: 150566 - RNA, 18 nt, Artificial Sequence
  Description of Artificial Sequence: Synthetic oligonucleotide
gcaggaagaacgcaauuu

SEQ ID NO: 150567 - RNA, 18 nt, Artificial Sequence
  Description of Artificial Sequence: Synthetic oligonucleotide
ucaaugcaggaagaacgc

SEQ ID NO: 150568 - RNA, 18 nt, Artificial Sequence
  Description of Artificial Sequence: Synthetic oligonucleotide
uuauuucaaugcaggaag

SEQ ID NO: 150569 - RNA, 18 nt, Artificial Sequence
  Description of Artificial Sequence: Synthetic oligonucleotide
uguuuuuauuucaaugca

SEQ ID NO: 150570 - RNA, 18 nt, Artificial Sequence
  Description of Artificial Sequence: Synthetic oligonucleotide
aauaauguuuuuauuuca

SEQ ID NO: 150571 - RNA, 18 nt, Artificial Sequence
  Description of Artificial Sequence: Synthetic oligonucleotide
uucccaauaauguuuuua

SEQ ID NO: 150572 - RNA, 18 nt, Artificial Sequence
  Description of Artificial Sequence: Synthetic oligonucleotide
cuaguuucccaauaaugu

SEQ ID NO: 150573 - RNA, 18 nt, Artificial Sequence
  Description of Artificial Sequence: Synthetic oligonucleotide
guucucuaguuucccaau

SEQ ID NO: 150574 - RNA, 18 nt, Artificial Sequence
  Description of Artificial Sequence: Synthetic oligonucleotide
gagguguucucuaguuuc

SEQ ID NO: 150575 - RNA, 18 nt, Artificial Sequence
  Description of Artificial Sequence: Synthetic oligonucleotide
aaauagagguguucucua

SEQ ID NO: 150576 - RNA, 18 nt, Artificial Sequence
  Description of Artificial Sequence: Synthetic oligonucleotide
uuuaaaaauagagguguu

SEQ ID NO: 150577 - RNA, 18 nt, Artificial Sequence
  Description of Artificial Sequence: Synthetic oligonucleotide
guccuuuuaaaaauagag

SEQ ID NO: 150578 - RNA, 18 nt, Artificial Sequence
  Description of Artificial Sequence: Synthetic oligonucleotide
uuaaaguccuuuuaaaaa

SEQ ID NO: 150579 - RNA, 18 nt, Artificial Sequence
  Description of Artificial Sequence: Synthetic oligonucleotide
cuucguuaaaguccuuuu

SEQ ID NO: 150580 - RNA, 18 nt, Artificial Sequence
  Description of Artificial Sequence: Synthetic oligonucleotide
uuugacuucguuaaaguc

SEQ ID NO: 150581 - RNA, 18 nt, Artificial Sequence
  Description of Artificial Sequence: Synthetic oligonucleotide
aguuguuugacuucguua

SEQ ID NO: 150582 - RNA, 18 nt, Artificial Sequence
  Description of Artificial Sequence: Synthetic oligonucleotide
uuauaaguuguuugacuu

SEQ ID NO: 150583 - RNA, 18 nt, Artificial Sequence
  Description of Artificial Sequence: Synthetic oligonucleotide
uagucuuauaaguuguuu

SEQ ID NO: 150584 - RNA, 18 nt, Artificial Sequence
  Description of Artificial Sequence: Synthetic oligonucleotide
aucacuagucuuauaagu

SEQ ID NO: 150585 - RNA, 18 nt, Artificial Sequence
  Description of Artificial Sequence: Synthetic oligonucleotide
agugaaucacuagucuua

SEQ ID NO: 150586 - RNA, 18 nt, Artificial Sequence
  Description of Artificial Sequence: Synthetic oligonucleotide
gccccagugaaucacuag

SEQ ID NO: 150587 - RNA, 18 nt, Artificial Sequence
  Description of Artificial Sequence: Synthetic oligonucleotide
auaaugccccagugaauc

SEQ ID NO: 150588 - RNA, 18 nt, Artificial Sequence
  Description of Artificial Sequence: Synthetic oligonucleotide
acaaaauaaugccccagu

SEQ ID NO: 150589 - RNA, 18 nt, Artificial Sequence
  Description of Artificial Sequence: Synthetic oligonucleotide
cucuaacaaaauaaugcc

SEQ ID NO: 150590 - RNA, 18 nt, Artificial Sequence
  Description of Artificial Sequence: Synthetic oligonucleotide
agguccucuaacaaaaua

SEQ ID NO: 150591 - RNA, 18 nt, Artificial Sequence
  Description of Artificial Sequence: Synthetic oligonucleotide
uuuuaagguccucuaaca

SEQ ID NO: 150592 - RNA, 18 nt, Artificial Sequence
  Description of Artificial Sequence: Synthetic oligonucleotide
aacaauuuuaagguccuc

SEQ ID NO: 150593 - RNA, 18 nt, Artificial Sequence
  Description of Artificial Sequence: Synthetic oligonucleotide
aaauaaacaauuuuaagg

SEQ ID NO: 150594 - RNA, 18 nt, Artificial Sequence
  Description of Artificial Sequence: Synthetic oligonucleotide
uuaaaaaauaaacaauuu

SEQ ID NO: 150595 - RNA, 18 nt, Artificial Sequence
  Description of Artificial Sequence: Synthetic oligonucleotide
cacauuuaaaaaauaaac

SEQ ID NO: 150596 - RNA, 18 nt, Artificial Sequence
  Description of Artificial Sequence: Synthetic oligonucleotide
ggaaucacauuuaaaaaa

SEQ ID NO: 150597 - RNA, 18 nt, Artificial Sequence
  Description of Artificial Sequence: Synthetic oligonucleotide
auaaaggaaucacauuua

SEQ ID NO: 150598 - RNA, 18 nt, Artificial Sequence
  Description of Artificial Sequence: Synthetic oligonucleotide
augccauaaaggaaucac

SEQ ID NO: 150599 - RNA, 18 nt, Artificial Sequence
  Description of Artificial Sequence: Synthetic oligonucleotide
cccuaaugccauaaagga

SEQ ID NO: 150600 - RNA, 18 nt, Artificial Sequence
  Description of Artificial Sequence: Synthetic oligonucleotide
cuuuacccuaaugccaua

SEQ ID NO: 150601 - RNA, 18 nt, Artificial Sequence
  Description of Artificial Sequence: Synthetic oligonucleotide
uucaucuuuacccuaaug

SEQ ID NO: 150602 - RNA, 18 nt, Artificial Sequence
  Description of Artificial Sequence: Synthetic oligonucleotide
auugcuucaucuuuaccc

SEQ ID NO: 150603 - RNA, 18 nt, Artificial Sequence
  Description of Artificial Sequence: Synthetic oligonucleotide
aaauuauugcuucaucuu

SEQ ID NO: 150604 - RNA, 18 nt, Artificial Sequence
  Description of Artificial Sequence: Synthetic oligonucleotide
uuuaaaaauuauugcuuc

SEQ ID NO: 150605 - RNA, 18 nt, Artificial Sequence
  Description of Artificial Sequence: Synthetic oligonucleotide
cacaauuuaaaaauuauu

SEQ ID NO: 150606 - RNA, 18 nt, Artificial Sequence
  Description of Artificial Sequence: Synthetic oligonucleotide
acauacacaauuuaaaaa

SEQ ID NO: 150607 - RNA, 18 nt, Artificial Sequence
  Description of Artificial Sequence: Synthetic oligonucleotide
uaugcacauacacaauuu

SEQ ID NO: 150608 - RNA, 18 nt, Artificial Sequence
  Description of Artificial Sequence: Synthetic oligonucleotide
cuucauaugcacauacac

SEQ ID NO: 150609 - RNA, 18 nt, Artificial Sequence
  Description of Artificial Sequence: Synthetic oligonucleotide
cugugcuucauaugcaca

SEQ ID NO: 150610 - RNA, 18 nt, Artificial Sequence
  Description of Artificial Sequence: Synthetic oligonucleotide
caugucugugcuucauau

SEQ ID NO: 150611 - RNA, 18 nt, Artificial Sequence
  Description of Artificial Sequence: Synthetic oligonucleotide
acaugcaugucugugcuu

SEQ ID NO: 150612 - RNA, 18 nt, Artificial Sequence
  Description of Artificial Sequence: Synthetic oligonucleotide
cacacacaugcaugucug

SEQ ID NO: 150613 - RNA, 18 nt, Artificial Sequence
  Description of Artificial Sequence: Synthetic oligonucleotide
acacacacacacaugcau

SEQ ID NO: 150614 - RNA, 18 nt, Artificial Sequence
  Description of Artificial Sequence: Synthetic oligonucleotide
cacagacacacacacaca

SEQ ID NO: 150615 - RNA, 18 nt, Artificial Sequence
  Description of Artificial Sequence: Synthetic oligonucleotide
acacacacagacacacac

SEQ ID NO: 150616 - RNA, 18 nt, Artificial Sequence
  Description of Artificial Sequence: Synthetic oligonucleotide
gacacacacacacagaca

SEQ ID NO: 150617 - RNA, 18 nt, Artificial Sequence
  Description of Artificial Sequence: Synthetic oligonucleotide
acacggacacacacacac

SEQ ID NO: 150618 - RNA, 18 nt, Artificial Sequence
  Description of Artificial Sequence: Synthetic oligonucleotide
cacauacacggacacaca

SEQ ID NO: 150619 - RNA, 18 nt, Artificial Sequence
  Description of Artificial Sequence: Synthetic oligonucleotide
acacacacauacacggac

SEQ ID NO: 150620 - RNA, 18 nt, Artificial Sequence
  Description of Artificial Sequence: Synthetic oligonucleotide
aacccacacacacauaca

SEQ ID NO: 150621 - RNA, 18 nt, Artificial Sequence
  Description of Artificial Sequence: Synthetic oligonucleotide
auuagaacccacacacac

SEQ ID NO: 150622 - RNA, 18 nt, Artificial Sequence
  Description of Artificial Sequence: Synthetic oligonucleotide
uuaccauuagaacccaca

SEQ ID NO: 150623 - RNA, 18 nt, Artificial Sequence
  Description of Artificial Sequence: Synthetic oligonucleotide
gcaaauuaccauuagaac

SEQ ID NO: 150624 - RNA, 18 nt, Artificial Sequence
  Description of Artificial Sequence: Synthetic oligonucleotide
cugaggcaaauuaccauu

SEQ ID NO: 150625 - RNA, 18 nt, Artificial Sequence
  Description of Artificial Sequence: Synthetic oligonucleotide
aaugacugaggcaaauua

SEQ ID NO: 150626 - RNA, 18 nt, Artificial Sequence
  Description of Artificial Sequence: Synthetic oligonucleotide
aaaaaaaugacugaggca

SEQ ID NO: 150627 - RNA, 18 nt, Artificial Sequence
  Description of Artificial Sequence: Synthetic oligonucleotide
auauuaaaaaaaugacug

SEQ ID NO: 150628 - RNA, 18 nt, Artificial Sequence
  Description of Artificial Sequence: Synthetic oligonucleotide
ugcaaauauuaaaaaaau

SEQ ID NO: 150629 - RNA, 18 nt, Artificial Sequence
  Description of Artificial Sequence: Synthetic oligonucleotide
aguacugcaaauauuaaa

SEQ ID NO: 150630 - RNA, 18 nt, Artificial Sequence
  Description of Artificial Sequence: Synthetic oligonucleotide
aaucaaguacugcaaaua

SEQ ID NO: 150631 - RNA, 18 nt, Artificial Sequence
  Description of Artificial Sequence: Synthetic oligonucleotide
uccuaaaucaaguacugc

SEQ ID NO: 150632 - RNA, 18 nt, Artificial Sequence
  Description of Artificial Sequence: Synthetic oligonucleotide
acagauccuaaaucaagu

SEQ ID NO: 150633 - RNA, 18 nt, Artificial Sequence
  Description of Artificial Sequence: Synthetic oligonucleotide
gcaccacagauccuaaau

SEQ ID NO: 150634 - RNA, 18 nt, Artificial Sequence
  Description of Artificial Sequence: Synthetic oligonucleotide
gcccugcaccacagaucc

SEQ ID NO: 150635 - RNA, 18 nt, Artificial Sequence
  Description of Artificial Sequence: Synthetic oligonucleotide
acauugcccugcaccaca

SEQ ID NO: 150636 - RNA, 18 nt, Artificial Sequence
  Description of Artificial Sequence: Synthetic oligonucleotide
uugaaacauugcccugca

SEQ ID NO: 150637 - RNA, 18 nt, Artificial Sequence
  Description of Artificial Sequence: Synthetic oligonucleotide
aaacuuugaaacauugcc

SEQ ID NO: 150638 - RNA, 18 nt, Artificial Sequence
  Description of Artificial Sequence: Synthetic oligonucleotide
ugacuaaacuuugaaaca

SEQ ID NO: 150639 - RNA, 18 nt, Artificial Sequence
  Description of Artificial Sequence: Synthetic oligonucleotide
agcugugacuaaacuuug

SEQ ID NO: 150640 - RNA, 18 nt, Artificial Sequence
  Description of Artificial Sequence: Synthetic oligonucleotide
uuuuaagcugugacuaaa

SEQ ID NO: 150641 - RNA, 18 nt, Artificial Sequence
  Description of Artificial Sequence: Synthetic oligonucleotide
aauguuuuuaagcuguga

SEQ ID NO: 150642 - RNA, 18 nt, Artificial Sequence
  Description of Artificial Sequence: Synthetic oligonucleotide
cacugaauguuuuuaagc

SEQ ID NO: 150643 - RNA, 18 nt, Artificial Sequence
  Description of Artificial Sequence: Synthetic oligonucleotide
agucacacugaauguuuu

SEQ ID NO: 150644 - RNA, 18 nt, Artificial Sequence
  Description of Artificial Sequence: Synthetic oligonucleotide
auuaaagucacacugaau

SEQ ID NO: 150645 - RNA, 18 nt, Artificial Sequence
  Description of Artificial Sequence: Synthetic oligonucleotide
auaauauuaaagucacac

SEQ ID NO: 150646 - RNA, 18 nt, Artificial Sequence
  Description of Artificial Sequence: Synthetic oligonucleotide
auuuuauaauauuaaagu

SEQ ID NO: 150647 - RNA, 18 nt, Artificial Sequence
  Description of Artificial Sequence: Synthetic oligonucleotide
aaaucauuuuauaauauu

SEQ ID NO: 150648 - RNA, 18 nt, Artificial Sequence
  Description of Artificial Sequence: Synthetic oligonucleotide
augggaaaucauuuuaua

SEQ ID NO: 150649 - RNA, 18 nt, Artificial Sequence
  Description of Artificial Sequence: Synthetic oligonucleotide
auggcaugggaaaucauu

SEQ ID NO: 150650 - RNA, 18 nt, Artificial Sequence
  Description of Artificial Sequence: Synthetic oligonucleotide
aaauuauggcaugggaaa

SEQ ID NO: 150651 - RNA, 18 nt, Artificial Sequence
  Description of Artificial Sequence: Synthetic oligonucleotide
cagaaaaauuauggcaug

SEQ ID NO: 150652 - RNA, 18 nt, Artificial Sequence
  Description of Artificial Sequence: Synthetic oligonucleotide
auagacagaaaaauuaug

SEQ ID NO: 150653 - RNA, 18 nt, Artificial Sequence
  Description of Artificial Sequence: Synthetic oligonucleotide
auuuaauagacagaaaaa

SEQ ID NO: 150654 - RNA, 18 nt, Artificial Sequence
  Description of Artificial Sequence: Synthetic oligonucleotide
gucccauuuaauagacag

SEQ ID NO: 150655 - RNA, 18 nt, Artificial Sequence
  Description of Artificial Sequence: Synthetic oligonucleotide
cacuugucccauuuaaua

SEQ ID NO: 150656 - RNA, 18 nt, Artificial Sequence
  Description of Artificial Sequence: Synthetic oligonucleotide
cuuuacacuugucccauu

SEQ ID NO: 150657 - RNA, 18 nt, Artificial Sequence
  Description of Artificial Sequence: Synthetic oligonucleotide
gcaugcuuuacacuuguc

SEQ ID NO: 150658 - RNA, 18 nt, Artificial Sequence
  Description of Artificial Sequence: Synthetic oligonucleotide
cuuuugcaugcuuuacac

SEQ ID NO: 150659 - RNA, 18 nt, Artificial Sequence
  Description of Artificial Sequence: Synthetic oligonucleotide
ucuaacuuuugcaugcuu

SEQ ID NO: 150660 - RNA, 18 nt, Artificial Sequence
  Description of Artificial Sequence: Synthetic oligonucleotide
agaucucuaacuuuugca

SEQ ID NO: 150661 - RNA, 18 nt, Artificial Sequence
  Description of Artificial Sequence: Synthetic oligonucleotide
auaacagaucucuaacuu

SEQ ID NO: 150662 - RNA, 18 nt, Artificial Sequence
  Description of Artificial Sequence: Synthetic oligonucleotide
guuauauaacagaucucu

SEQ ID NO: 150663 - RNA, 18 nt, Artificial Sequence
  Description of Artificial Sequence: Synthetic oligonucleotide
caaauguuauauaacaga

SEQ ID NO: 150664 - RNA, 18 nt, Artificial Sequence
  Description of Artificial Sequence: Synthetic oligonucleotide
caaaacaaauguuauaua

SEQ ID NO: 150665 - RNA, 18 nt, Artificial Sequence
  Description of Artificial Sequence: Synthetic oligonucleotide
aaucacaaaacaaauguu

SEQ ID NO: 150666 - RNA, 18 nt, Artificial Sequence
  Description of Artificial Sequence: Synthetic oligonucleotide
guucaaaucacaaaacaa

SEQ ID NO: 150667 - RNA, 18 nt, Artificial Sequence
  Description of Artificial Sequence: Synthetic oligonucleotide
uaggaguucaaaucacaa

SEQ ID NO: 150668 - RNA, 18 nt, Artificial Sequence
  Description of Artificial Sequence: Synthetic oligonucleotide
uuuccuaggaguucaaau

SEQ ID NO: 150669 - RNA, 18 nt, Artificial Sequence
  Description of Artificial Sequence: Synthetic oligonucleotide
auauuuuuccuaggaguu

SEQ ID NO: 150670 - RNA, 18 nt, Artificial Sequence
  Description of Artificial Sequence: Synthetic oligonucleotide
aaaucauauuuuuccuag

SEQ ID NO: 150671 - RNA, 18 nt, Artificial Sequence
  Description of Artificial Sequence: Synthetic oligonucleotide
uuaugaaaucauauuuuu

SEQ ID NO: 150672 - RNA, 18 nt, Artificial Sequence
  Description of Artificial Sequence: Synthetic oligonucleotide
uacauuuaugaaaucaua

SEQ ID NO: 150673 - RNA, 18 nt, Artificial Sequence
  Description of Artificial Sequence: Synthetic oligonucleotide
cauuuuacauuuaugaaa

SEQ ID NO: 150674 - RNA, 18 nt, Artificial Sequence
  Description of Artificial Sequence: Synthetic oligonucleotide
cugugcauuuuacauuua

SEQ ID NO: 150675 - RNA, 18 nt, Artificial Sequence
  Description of Artificial Sequence: Synthetic oligonucleotide
cauuucugugcauuuuac

SEQ ID NO: 150676 - RNA, 18 nt, Artificial Sequence
  Description of Artificial Sequence: Synthetic oligonucleotide
gcaugcauuucugugcau

SEQ ID NO: 150677 - RNA, 18 nt, Artificial Sequence
  Description of Artificial Sequence: Synthetic oligonucleotide
guauugcaugcauuucug

SEQ ID NO: 150678 - RNA, 18 nt, Artificial Sequence
  Description of Artificial Sequence: Synthetic oligonucleotide
uauaaguauugcaugcau

SEQ ID NO: 150679 - RNA, 18 nt, Artificial Sequence
  Description of Artificial Sequence: Synthetic oligonucleotide
agucuuauaaguauugca

SEQ ID NO: 150680 - RNA, 18 nt, Artificial Sequence
  Description of Artificial Sequence: Synthetic oligonucleotide
uuuuaagucuuauaagua

SEQ ID NO: 150681 - RNA, 18 nt, Artificial Sequence
  Description of Artificial Sequence: Synthetic oligonucleotide
acaauuuuuaagucuuau

SEQ ID NO: 150682 - RNA, 18 nt, Artificial Sequence
  Description of Artificial Sequence: Synthetic oligonucleotide
uaaacacaauuuuuaagu

SEQ ID NO: 150683 - RNA, 18 nt, Artificial Sequence
  Description of Artificial Sequence: Synthetic oligonucleotide
aucuguaaacacaauuuu

SEQ ID NO: 150684 - RNA, 18 nt, Artificial Sequence
  Description of Artificial Sequence: Synthetic oligonucleotide
aaaccaucuguaaacaca

SEQ ID NO: 150685 - RNA, 18 nt, Artificial Sequence
  Description of Artificial Sequence: Synthetic oligonucleotide
caaauaaaccaucuguaa

SEQ ID NO: 150686 - RNA, 18 nt, Artificial Sequence
  Description of Artificial Sequence: Synthetic oligonucleotide
augcacaaauaaaccauc

SEQ ID NO: 150687 - RNA, 18 nt, Artificial Sequence
  Description of Artificial Sequence: Synthetic oligonucleotide
aaaauaugcacaaauaaa

SEQ ID NO: 150688 - RNA, 18 nt, Artificial Sequence
  Description of Artificial Sequence: Synthetic oligonucleotide
uaguaaaaauaugcacaa

SEQ ID NO: 150689 - RNA, 18 nt, Artificial Sequence
  Description of Artificial Sequence: Synthetic oligonucleotide
agcaguaguaaaaauaug

SEQ ID NO: 150690 - RNA, 18 nt, Artificial Sequence
  Description of Artificial Sequence: Synthetic oligonucleotide
ggaaaagcaguaguaaaa

SEQ ID NO: 150691 - RNA, 18 nt, Artificial Sequence
  Description of Artificial Sequence: Synthetic oligonucleotide
auuuaggaaaagcaguag

SEQ ID NO: 150692 - RNA, 18 nt, Artificial Sequence
  Description of Artificial Sequence: Synthetic oligonucleotide
uaugcauuuaggaaaagc

SEQ ID NO: 150693 - RNA, 18 nt, Artificial Sequence
  Description of Artificial Sequence: Synthetic oligonucleotide
uacaguaugcauuuagga

SEQ ID NO: 150694 - RNA, 18 nt, Artificial Sequence
  Description of Artificial Sequence: Synthetic oligonucleotide
uuauauacaguaugcauu

SEQ ID NO: 150695 - RNA, 18 nt, Artificial Sequence
  Description of Artificial Sequence: Synthetic oligonucleotide
cagaauuauauacaguau

SEQ ID NO: 150696 - RNA, 18 nt, Artificial Sequence
  Description of Artificial Sequence: Synthetic oligonucleotide
auacacagaauuauauac

SEQ ID NO: 150697 - RNA, 18 nt, Artificial Sequence
  Description of Artificial Sequence: Synthetic oligonucleotide
aucaaauacacagaauua

SEQ ID NO: 150698 - RNA, 18 nt, Artificial Sequence
  Description of Artificial Sequence: Synthetic oligonucleotide
uauuuaucaaauacacag

SEQ ID NO: 150699 - RNA, 18 nt, Artificial Sequence
  Description of Artificial Sequence: Synthetic oligonucleotide
agaaauauuuaucaaaua

SEQ ID NO: 150700 - RNA, 18 nt, Artificial Sequence
  Description of Artificial Sequence: Synthetic oligonucleotide
uaggaagaaauauuuauc

SEQ ID NO: 150701 - RNA, 18 nt, Artificial Sequence
  Description of Artificial Sequence: Synthetic oligonucleotide
uaauguaggaagaaauau

SEQ ID NO: 150702 - RNA, 18 nt, Artificial Sequence
  Description of Artificial Sequence: Synthetic oligonucleotide
aaauauaauguaggaaga

SEQ ID NO: 150703 - RNA, 18 nt, Artificial Sequence
  Description of Artificial Sequence: Synthetic oligonucleotide
ucuaaaaauauaauguag

SEQ ID NO: 150704 - RNA, 18 nt, Artificial Sequence
  Description of Artificial Sequence: Synthetic oligonucleotide
aauauucuaaaaauauaa

SEQ ID NO: 150705 - RNA, 18 nt, Artificial Sequence
  Description of Artificial Sequence: Synthetic oligonucleotide
ucugaaauauucuaaaaa

SEQ ID NO: 150706 - RNA, 18 nt, Artificial Sequence
  Description of Artificial Sequence: Synthetic oligonucleotide
auauuucugaaauauucu

SEQ ID NO: 150707 - RNA, 18 nt, Artificial Sequence
  Description of Artificial Sequence: Synthetic oligonucleotide
aauguauauuucugaaau

SEQ ID NO: 150708 - RNA, 18 nt, Artificial Sequence
  Description of Artificial Sequence: Synthetic oligonucleotide
acauaaauguauauuucu

SEQ ID NO: 150709 - RNA, 18 nt, Artificial Sequence
  Description of Artificial Sequence: Synthetic oligonucleotide
uaaagacauaaauguaua

SEQ ID NO: 150710 - RNA, 18 nt, Artificial Sequence
  Description of Artificial Sequence: Synthetic oligonucleotide
caauauaaagacauaaau

SEQ ID NO: 150711 - RNA, 18 nt, Artificial Sequence
  Description of Artificial Sequence: Synthetic oligonucleotide
uauuacaauauaaagaca

SEQ ID NO: 150712 - RNA, 18 nt, Artificial Sequence
  Description of Artificial Sequence: Synthetic oligonucleotide
auauuuauuacaauauaa

SEQ ID NO: 150713 - RNA, 18 nt, Artificial Sequence
  Description of Artificial Sequence: Synthetic oligonucleotide
uguacauauuuauuacaa

SEQ ID NO: 150714 - RNA, 18 nt, Artificial Sequence
  Description of Artificial Sequence: Synthetic oligonucleotide
agauauguacauauuuau

SEQ ID NO: 150715 - RNA, 18 nt, Artificial Sequence
  Description of Artificial Sequence: Synthetic oligonucleotide
uaccuagauauguacaua

SEQ ID NO: 150716 - RNA, 18 nt, Artificial Sequence
  Description of Artificial Sequence: Synthetic oligonucleotide
gcauauaccuagauaugu

SEQ ID NO: 150717 - RNA, 18 nt, Artificial Sequence
  Description of Artificial Sequence: Synthetic oligonucleotide
agaaagcauauaccuaga

SEQ ID NO: 150718 - RNA, 18 nt, Artificial Sequence
  Description of Artificial Sequence: Synthetic oligonucleotide
cagagagaaagcauauac

SEQ ID NO: 150719 - RNA, 18 nt, Artificial Sequence
  Description of Artificial Sequence: Synthetic oligonucleotide
cacagcagagagaaagca

SEQ ID NO: 150720 - RNA, 18 nt, Artificial Sequence
  Description of Artificial Sequence: Synthetic oligonucleotide
aauuucacagcagagaga

SEQ ID NO: 150721 - RNA, 18 nt, Artificial Sequence
  Description of Artificial Sequence: Synthetic oligonucleotide
aaaauaauuucacagcag

SEQ ID NO: 150722 - RNA, 18 nt, Artificial Sequence
  Description of Artificial Sequence: Synthetic oligonucleotide
uucuaaaaauaauuucac

SEQ ID NO: 150723 - RNA, 18 nt, Artificial Sequence
  Description of Artificial Sequence: Synthetic oligonucleotide
uauaauucuaaaaauaau

SEQ ID NO: 150724 - RNA, 18 nt, Artificial Sequence
  Description of Artificial Sequence: Synthetic oligonucleotide
gaauuuauaauucuaaaa

SEQ ID NO: 150725 - RNA, 18 nt, Artificial Sequence
  Description of Artificial Sequence: Synthetic oligonucleotide
gacgugaauuuauaauuc

SEQ ID NO: 150726 - RNA, 18 nt, Artificial Sequence
  Description of Artificial Sequence: Synthetic oligonucleotide
gacaagacgugaauuuau

SEQ ID NO: 150727 - RNA, 18 nt, Artificial Sequence
  Description of Artificial Sequence: Synthetic oligonucleotide
aaucugacaagacgugaa

SEQ ID NO: 150728 - RNA, 18 nt, Artificial Sequence
  Description of Artificial Sequence: Synthetic oligonucleotide
gaugaaaucugacaagac

SEQ ID NO: 150729 - RNA, 18 nt, Artificial Sequence
  Description of Artificial Sequence: Synthetic oligonucleotide
auacagaugaaaucugac

SEQ ID NO: 150730 - RNA, 18 nt, Artificial Sequence
  Description of Artificial Sequence: Synthetic oligonucleotide
aagguauacagaugaaau

SEQ ID NO: 150731 - RNA, 18 nt, Artificial Sequence
  Description of Artificial Sequence: Synthetic oligonucleotide
auuugaagguauacagau

SEQ ID NO: 150732 - RNA, 18 nt, Artificial Sequence
  Description of Artificial Sequence: Synthetic oligonucleotide
agagaauuugaagguaua

SEQ ID NO: 150733 - RNA, 18 nt, Artificial Sequence
  Description of Artificial Sequence: Synthetic oligonucleotide
cuuucagagaauuugaag

SEQ ID NO: 150734 - RNA, 18 nt, Artificial Sequence
  Description of Artificial Sequence: Synthetic oligonucleotide
uuuuacuuucagagaauu

SEQ ID NO: 150735 - RNA, 18 nt, Artificial Sequence
  Description of Artificial Sequence: Synthetic oligonucleotide
uuuauuuuuacuuucaga

SEQ ID NO: 150736 - RNA, 18 nt, Artificial Sequence
  Description of Artificial Sequence: Synthetic oligonucleotide
aaacuuuuauuuuuacuu

SEQ ID NO: 150737 - RNA, 18 nt, Artificial Sequence
  Description of Artificial Sequence: Synthetic oligonucleotide
uuuaaaaacuuuuauuuu

SEQ ID NO: 150738 - DNA, 1971 bp, Homo sapiens; identical to SEQ ID NO: 61481

SEQ ID NO: 150739 - DNA, 73215 bp, Homo sapiens; identical to SEQ ID NO: 139877

SEQ ID NO: 150740 - DNA, 9295 bp, Homo sapiens; identical to SEQ ID NO: 139917

SEQ ID NO: 150741 - DNA, 1451 bp, Homo sapiens; identical to SEQ ID NO: 139862

SEQ ID NO: 150742 - DNA, 3722 bp, Homo sapiens
tcctgaagttgagtttgagaggcgacacggcggcggcggccgcgctgctcccgctcctctgcctccccatggatatgcactgcaaagcagaccccttctccgcgatgcaccgtgagtaccggcgcccggctcctgtcccggctcggggctctccgtcccaaccctgtccagtcccagcgtggccccggcccctcgcgctcaggtcccatcttggaggcctccctggcttctggtccctcttttcgttctttctctccctcgcccggtgtttctaatgcctccagtttctctcctgccttctgtcacccattcttacctctctgtctgcctgccttcctaccttccctgatccctatcacctgcctttgctctttctatccgctccttcttaggtcatgggatccacggcctcggagccctggttccagccaccctctccctagtcagcctcttgccctgggctggggggcaaattagcaggcagttttcagggtgttgttttgttgttttctctgtcttttctctctttctctcttcctctgtttgcctccctctcctgtctccccacatctttatctttctcaaacttaagagtcgtggggtccaggagactccaagagtattcagcctcagtgtcaggacaattgggcagaagagtgtgggggtggggtgcccccttctgaccctcatctctcagcatctccaggcccttccagcccagcataggcttcttgtgggttggtttgaaatattttcttcctcttcctttctttcccaccccccttcccttgccttcccttcccttcacattgggaatcccaggttgtcaagacacgatggtcatctttccctgcctctgcctgggggatgctctaaaaacaaagaggggctccgagaagaaatcgaagtcagggagagagccagcagcgcagccttccaggtgggcccccggcagagtgcagctctgctctcagctctggaggctccttgcctagactgccgactccccattgaggatcacgcagccagcaacctggccagggggtcagcaaagagcaaaaaatgagggggaaagaacaaaaggaaagcaaatgccaaagctgaggagaaaggaaaagagaaatccaaacacgggaaaggaaattaaagaaagaaagttgacatgatgttacagaagaaaagggagaagggagaaaaaaatagagaaaagagggaattattttaataaaatttgaatttatgccatgtctttagcttgaaaaactattctgagattttttttgcaggcttttttttttaaaagctaaaattctaaatagaaaactcctccctatctgcagattaataattaaggataatttgtaacttttcacaaggaaactttagacccggcttggacctgtgtttaggacaagagagccgaggagggagagctgtgtttttcgctaatcatatatttagcgttgcgggggttggggggggcgtttaaaaatacttctgggataaaatatatttttctaagtaatttccaagcgcaggaaagccgcgccgagggcatcaggcctccgcgggtctcggcgagcgggccggaaagcctcggtccttttcgggaggagtggaaccgggtccacacgccgttttcgcccagccagcctgcctcgcggcccgctgccacagctctcgttctccttttttgcggattccgccgggggtccgccgagtcctggctgcccgcgggcagccactttgaaacccaaaggtttctgcacggccaagcagaggtcggagggagagagccgcagcgcgggcccgcgggccggtggactggtgggtgagacaccgcagcccgagtcggtgctggcggccgtggcgcattccaggcccgactcagcgccgactcgctgcagtcccccagccctggactcccgccgtgtccccttcccatccccaccccttagactggggctgaggggccgggccctgagcccggggaggctgaattattcatctttaatctgcccgcagctgccgccttttcataccggtaacgcgagttctcccggggcctaaattattgatggtcggggtttggagggaggggagggtgagaagtggggctagagatagggagattaacggggtgggcaagggggtaaaagaaggggcttcagtctctcccagcaacgcgatcagaggtctttccccagggtttcaccgagcttgctctaggtaccccccgagaaagggaggggagagaaatgaggggggcacagatgtccccgctttctccgaaactcgcgtgaggctagcggggcaggggctgcagcttgccagtccgggccgacccgactcggccgctagaagtctctgcgcttggattgctcagtacctgcggctacgggttgatcgctctgggtgcaggatttctagactgctgtaggccagggagaatggggcacaggaagcaccctcaggcctggcacccagtggccgcctcggttccgagatcgggagcccgcgctggagccgggttggaaaccccgtgcccttctcttggccgaaagagcaaaagcccgagccgctcggtttcctgggggggctgccgaggtctgaggggtcaaagggactcgagtcgggtttgggtcggctacacagggcgccccgagagttattaactcgccagcgaggcctatgccgtgccacctgggcgagacggtgggccccaaccaggctctgcgaggcgcggcaggcaggcgagcccaagcagccggcattctctgcctgctgcctggagccgctctgcctccctgtctctgagcgcagcagaccccgggcccctgcctcatccgccttccttgctctacttcagatactaaggaggtgaaagagagatacggtccccctacagataaataacattagaaaaacttcccatcaaaaacaaacaacacaggaaagaggtagaaaaattccgattacaatttaatactttttaaagaagaggcagagagcaaaggggggtgtgtgtgtcaggcacttatcccctgtctgtgctaggagctcggataaacagtcagccgagcctcgacgcccccaaatcgtccgcctccaagccccgcacgcgcggacagctcccgggttgcctgcggcgcaggcgggatgctgcttcgcactagtccagtcctctgccaggcccttcctctcctcgctttcttacgccctttccgctggcatgaattcccctttggcattttctcccctctcccctcttttctgtcatctggtttctctccagtcccccctttgctttctaccttgcgtcgcaaggcctgagtcgccctctcgcccagcccccagtcttcagcccagcgtctgtgcttccagtccccactcctccgcgtggtcgtggaggtccaccacctttcttctcaagctcgggaacatgcccttccgccctgcctgcttccttcgcccgtcccgggccgcggaccctgactaatggccggtccctgctgtgtgtggggtgttgtgtttttttcttgtctctccccagcagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcag

SEQ ID NO: 150743 - DNA, 2329 bp, Homo sapiens; identical to SEQ ID NO: 139975

SEQ ID NO: 150744 - DNA, 4204 bp, Homo sapiens
cgggggcctggcccgcgcgctcccctcccgcaggcgccacctcggacatccccgggattgctacttctctgccaacttcgccaactcgccagcacttggagaggcccggctcccctcccggcgccctctgaccgcccccgccccgcgcgctctccgaccaccgcctctcggatgaccaggttccaggggagctgagcgagtcgcctcccccgcccagcttcagccctggctgcagctgcagcgcgagccatgcgcccccagtgcaccccggcccggcccaccgccccggggccattctgctgaccgcccagccccgagccccgacagtggcaagttgcggctactgcagttgcaagctccggccaacccggaggagccccagcggggagcgcagtgctgcgccccccgcccccgcgcgccccgcagcagccgggcgttcactcatcctccctcccccaccgtccctcccttttctcctcaagtcctgaagttgagtttgagaggcgacacggcggcggcggccgcgctgctcccgctcctctgcctccccatggatatgcactgcaaagcagaccccttctccgcgatgcaccgtgagtaccggcgcccggctcctgtcccggctcggggctctccgtcccaaccctgtccagtcccagcgtggccccggcccctcgcgctcaggtcccatcttggaggcctccctggcttctggtccctcttttcgttctttctctccctcgcccggtgtttctaatgcctccagtttctctcctgccttctgtcacccattcttacctctctgtctgcctgccttcctaccttccctgatccctatcacctgcctttgctctttctatccgctccttcttaggtcatgggatccacggcctcggagccctggttccagccaccctctccctagtcagcctcttgccctgggctggggggcaaattagcaggcagttttcagggtgttgttttgttgttttctctgtcttttctctctttctctcttcctctgtttgcctccctctcctgtctccccacatctttatctttctcaaacttaagagtcgtggggtccaggagactccaagagtattcagcctcagtgtcaggacaattgggcagaagagtgtgggggtggggtgcccccttctgaccctcatctctcagcatctccaggcccttccagcccagcataggcttcttgtgggttggtttgaaatattttcttcctcttcctttctttcccaccccccttcccttgccttcccttcccttcacattgggaatcccaggttgtcaagacacgatggtcatctttccctgcctctgcctgggggatgctctaaaaacaaagaggggctccgagaagaaatcgaagtcagggagagagccagcagcgcagccttccaggtgggcccccggcagagtgcagctctgctctcagctctggaggctccttgcctagactgccgactccccattgaggatcacgcagccagcaacctggccagggggtcagcaaagagcaaaaaatgagggggaaagaacaaaaggaaagcaaatgccaaagctgaggagaaaggaaaagagaaatccaaacacgggaaaggaaattaaagaaagaaagttgacatgatgttacagaagaaaagggagaagggagaaaaaaatagagaaaagagggaattattttaataaaatttgaatttatgccatgtctttagcttgaaaaactattctgagattttttttgcaggcttttttttttaaaagctaaaattctaaatagaaaactcctccctatctgcagattaataattaaggataatttgtaacttttcacaaggaaactttagacccggcttggacctgtgtttaggacaagagagccgaggagggagagctgtgtttttcgctaatcatatatttagcgttgcgggggttggggggggcgtttaaaaatacttctgggataaaatatatttttctaagtaatttccaagcgcaggaaagccgcgccgagggcatcaggcctccgcgggtctcggcgagcgggccggaaagcctcggtccttttcgggaggagtggaaccgggtccacacgccgttttcgcccagccagcctgcctcgcggcccgctgccacagctctcgttctccttttttgcggattccgccgggggtccgccgagtcctggctgcccgcgggcagccactttgaaacccaaaggtttctgcacggccaagcagaggtcggagggagagagccgcagcgcgggcccgcgggccggtggactggtgggtgagacaccgcagcccgagtcggtgctggcggccgtggcgcattccaggcccgactcagcgccgactcgctgcagtcccccagccctggactcccgccgtgtccccttcccatccccaccccttagactggggctgaggggccgggccctgagcccggggaggctgaattattcatctttaatctgcccgcagctgccgccttttcataccggtaacgcgagttctcccggggcctaaattattgatggtcggggtttggagggaggggagggtgagaagtggggctagagatagggagattaacggggtgggcaagggggtaaaagaaggggcttcagtctctcccagcaacgcgatcagaggtctttccccagggtttcaccgagcttgctctaggtaccccccgagaaagggaggggagagaaatgaggggggcacagatgtccccgctttctccgaaactcgcgtgaggctagcggggcaggggctgcagcttgccagtccgggccgacccgactcggccgctagaagtctctgcgcttggattgctcagtacctgcggctacgggttgatcgctctgggtgcaggatttctagactgctgtaggccagggagaatggggcacaggaagcaccctcaggcctggcacccagtggccgcctcggttccgagatcgggagcccgcgctggagccgggttggaaaccccgtgcccttctcttggccgaaagagcaaaagcccgagccgctcggtttcctgggggggctgccgaggtctgaggggtcaaagggactcgagtcgggtttgggtcggctacacagggcgccccgagagttattaactcgccagcgaggcctatgccgtgccacctgggcgagacggtgggccccaaccaggctctgcgaggcgcggcaggcaggcgagcccaagcagccggcattctctgcctgctgcctggagccgctctgcctccctgtctctgagcgcagcagaccccgggcccctgcctcatccgccttccttgctctacttcagatactaaggaggtgaaagagagatacggtccccctacagataaataacattagaaaaacttcccatcaaaaacaaacaacacaggaaagaggtagaaaaattccgattacaatttaatactttttaaagaagaggcagagagcaaaggggggtgtgtgtgtcaggcacttatcccctgtctgtgctaggagctcggataaacagtcagccgagcctcgacgcccccaaatcgtccgcctccaagccccgcacgcgcggacagctcccgggttgcctgcggcgcaggcgggatgctgcttcgcactagtccagtcctctgccaggcccttcctctcctcgctttcttacgccctttccgctggcatgaattcccctttggcattttctcccctctcccctcttttctgtcatctggtttctctccagtcccccctttgctttctaccttgcgtcgcaaggcctgagtcgccctctcgcccagcccccagtcttcagcccagcgtctgtgcttccagtccccactcctccgcgtggtcgtggaggtccaccacctttcttctcaagctcgggaacatgcccttccgccctgcctgcttccttcgcccgtcccgggccgcggaccctgactaatggccggtccctgctgtgtgtggggtgttgtgtttttttcttgtctctccccagcagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcag

SEQ ID NO: 150745 - DNA, 996 bp, Homo sapiens
gcttacgccgagtgtaccatttacaactcggactcttgacaaggcaacagttctgggtgaatatgctttacccaaaggagtaagtagaatttgtatattctataccttacaaaaccttggaagatacactttgcaaatattcaccagatctccctagactttgtactggaaaatattcattttgggaatgcagagatggtagagaatagttgacatgttgcatagtatagaattagaattcacggctatggagacagagacctgcattcagtttcatcttttatctgtgttgtcttgagtgagttacataatctctgtgagcctcaacttcgtctgtaaaaggggtttaataacagaatctgctgcgcagggtggttgtgagtatggtgcacaattctaaagccctttacctatttattacctggcacattttaagcactcagcgcatgttggcaaccatcattattataaatttgtggatttggcttttgatttgtaaggtgacaacttgtgtcaattttgccattcaaaggtctcttctggttattttaaatactatgtgtctctgcatgtgtttagacagtgctcatgctaaatacccaggtgttgggatccagtgaagacaattttgaagattcaagtcagtttagacctgaacgttggcttcaggagaaggaaaaaattaatccttttgcgcatcttccatttggcgttggaaaaagaatgtgcattggtcgccgattagcagagcttcaactgcatttggctctttgttgggtaaaacctttaccggtttctgcaattatgttctgtgctgtttcacaaggcagaagaagagaggggtaattctgtttttgtgtgcgtgtgcattacagattgtccgcaaatacgacatccaggccacagacaatgagcctgttgagatgctacactcaggcaccctggtgcccagccgggaactccccatcgcgttttgccagcgataatacgcctcag

SEQ ID NO: 150746 - DNA, 3863 bp, Homo sapiens; identical to SEQ ID NO: 139898

SEQ ID NO: 150747 - DNA, 834 bp, Homo sapiens; identical to SEQ ID NO: 139860

SEQ ID NO: 150748 - DNA, 13162 bp, Homo sapiens; identical to SEQ ID NO: 139993

SEQ ID NO: 150749 - DNA, 3841 bp, Homo sapiens
attgtccgcaaatacgacatccaggccacagacaatgagcctgttgagatgctacactcaggcaccctggtgcccagccgggaactccccatcgcgttttgccagcgataatacgcctcaggtgagcatctaggcggttcattatcctctgcaaggtagtgagaatgacgagggatgagctatgctgggaagtcagccagactggggtttgaatcccagctcacctctaacttgctgggtgaccttgagcagttccctaaactctctacttcctttttttttttcatttgtaaaatgatgacccaaagagagtgtatcacaaaaatttaatatgaataccaagtagttattcctgagcctggcatcaattaagtgttcagtaaatgctagcagctgttcatggtttttgcatgtgaatagtaagggttggcaaactttttccgtaaagggccagttggcaaatattttaggttttatggaccatacagtctttgtcacatcctcttaatactaccttggaacatgaaagcagccacaggcaatttgtaaactaatgagtgagctgatgtcctagctttctattgctgccaccgcaaattactaaaacttagtgagttacacgacacacatctattatcttacagttctataggtcagaagtctgatgaggctcttccaggctaaaattatcgtgttgtcggggctctttctggaggttctagaggaggatctattctcttgctagtttggttgttggcagaatttagttcttcatggttacaggactgaagtctttatttttttgctgctgtcagctgaaggcgatcctcaactttgagagatttcccatattccttggctcatgaaaccttccccaactgaaagccagtaacaatggttggttgagtccctctcacactttgaatctctctttcttcttacattgcttctgtctgacaagatattatccaggatcatgtctcccatctccaagttcataaatttaatttcatctggaaagccctttttttcatataaggtagtatattcacgtgttccagggattagggcattcacattttaggagatctgttattctgcctacaaaggctgtgttctgataaattttataaaaaacaagcggtggactgtatttagccctagggtctaggtttgtgttatgcaaccacatgtaatataaatgtatatatttatcagcctgtattgaacacaatagaatattttttctgcagtatgccattcaatactttttctgacaatagaggagttctcatgttccctccacaacttttgccatgtccatataccaaccaggtgctatttatttcaatactactgagttatttcctttaaataacataagccaaatagcatatgttggcctcgtcctgagtaataatttccttaatgaaattaagagttagtaagtctagttatgttctcctaatagacattacaatgaattcaaaactattgaagtgatcaaaagttagcctaagaaggccctaatttttttttttttttttttttttgagacagtgtctcacactgtcacctgggctggagtgcaatggtgcaatctcagctcactgcaacctccgcctcctgggttcatgcgattcttctgcctcagcctcccgagtagctgggattacaggcaggtgcacaccaccacacccagctaattttttgtatttttagtagagatggggtttcattatgttggccagactggtcttgaactcctgacctcgtgatccacccgcctcggcctcccaaagtgctgggattgcaagtgtgagccaccacccctggtggtggaaataagacatttgtaacatatggctttataggctgacatgtcggtgtttaaacccggattctatcattgtgttcttttagcagcaccttctaggattttcctagaaaaaaatgctgtttgccaatggcaagttaaggagcatttgcttattggtagattatttagagaaacatgcaattacagatgaaatttctgaacaaggcccaaatgaatacattattattcctccaccaagtgtctgatgctattatgaaatttgtcaaattctgagcatcccaaccaacagaactgaatcaagtagggtaaggaaagtattctagctgcattgtgacaccccagccttcagcaaagagcatgcatgtttatcacagtaagccacaccttttaagttttagcattttttctttggctaataatttgtcttgtttaaatacacttctttgatatacaattagggtataccttttttttttttttttttttttttttttttttttttttttttttaccaagaccaaaacagccatttcaacttttctgcaagaatggtgcttatggcttctacgttaccggaaagcaaacttcaaacaccacaccatacaacagcttataaagaatatttaggcccaggtgttgatactttttcttctgcaaaattgttccagaagctgtactgtctttctagatggtggtatttgctaacatcatatccaactcagggaagcggactgagtgctgggatccaaggcattctacagggttcactgctggtttacacttcacctgtgtcagcaccatcttcaggtgcttagaatggcctgggagcctgttctgtcttgcatcttccatgacatgaaagggaggctggcacttgtcagtcaggtagaggttacaaaccgtttcaggccctgcctaccacattcactgtttgaatctttaattcccaagaataagtttacatttcacaatgaatgacctacaacagctaaattttctggggctgggagtaatactgacaatccatttactgtagctctgcttaatgtactacttaggaaaatgtccctgcttaataatgtaagccaagctaaatgatggttaaagttatcaggcctcccatgaaattgcgttcttcctgcattgaaataaaaacattattgggaaactagagaacacctctatttttaaaaggactttaacgaagtcaaacaacttataagactagtgattcactggggcattattttgttagaggaccttaaaattgtttattttttaaatgtgattcctttatggcattagggtaaagatgaagcaataatttttaaattgtgtatgtgcatatgaagcacagacatgcatgtgtgtgtgtgtctgtgtgtgtgtgtccgtgtatgtgtgtgtgggttctaatggtaatttgcctcagtcatttttttaatatttgcagtacttgatttaggatctgtggtgcagggcaatgtttcaaagtttagtcacagcttaaaaacattcagtgtgactttaatattataaaatgatttcccatgccataatttttctgtctattaaatgggacaagtgtaaagcatgcaaaagttagagatctgttatataacatttgttttgtgatttgaactcctaggaaaaatatgatttcataaatgtaaaatgcacagaaatgcatgcaatacttataagacttaaaaattgtgtttacagatggtttatttgtgcatatttttactactgcttttcctaaatgcatactgtatataattctgtgtatttgataaatatttcttcctacattatatttttagaatatttcagaaatatacatttatgtctttatattgtaataaatatgtacatatctaggtatatgctttctctctgctgtgaaattatttttagaattataaattcacgtcttgtcagatttcatctgtataccttcaaattctctgaaagtaaaaataaaagtttttaaatatt

SEQ ID NO: 150750 - DNA, 417 bp, Homo sapiens
acagtgctcatgctaaatacccaggtgttgggatccagtgaagacaattttgaagattcaagtcagtttagacctgaacgttggcttcaggagaaggaaaaaattaatccttttgcgcatcttccatttggcgttggaaaaagaatgtgcattggtcgccgattagcagagcttcaactgcatttggctctttgttgggtaaaacctttaccggtttctgcaattatgttctgtgctgtttcacaaggcagaagaagagaggggtaattctgtttttgtgtgcgtgtgcattacagattgtccgcaaatacgacatccaggccacagacaatgagcctgttgagatgctacactcaggcaccctggtgcccagccgggaactccccatcgcgttttgccagcgataatacgcctcag

SEQ ID NO: 150751 - DNA, 1832 bp, Homo sapiens; identical to SEQ ID NO: 139981

SEQ ID NO: 150752 - DNA, 1500 bp, Homo sapiens; identical to SEQ ID NO: 61479

SEQ ID NO: 150753 - RNA, 18 nt, Artificial Sequence
  Description of Artificial Sequence: Synthetic oligonucleotide
gcagugguaguaaguggg

SEQ ID NO: 150754 - RNA, 18 nt, Artificial Sequence
  Description of Artificial Sequence: Synthetic oligonucleotide
ccugggagaguucaaggg

SEQ ID NO: 150755 - RNA, 18 nt, Artificial Sequence
  Description of Artificial Sequence: Synthetic oligonucleotide
acagcccugggagaguuc

SEQ ID NO: 150756 - RNA, 18 nt, Artificial Sequence
  Description of Artificial Sequence: Synthetic oligonucleotide
cuccgacagcccugggag

SEQ ID NO: 150757 - RNA, 18 nt, Artificial Sequence
  Description of Artificial Sequence: Synthetic oligonucleotide
aucugcuccgacagcccu

SEQ ID NO: 150758 - RNA, 18 nt, Artificial Sequence
  Description of Artificial Sequence: Synthetic oligonucleotide
ucaggaucugcuccgaca

SEQ ID NO: 150759 - RNA, 18 nt, Artificial Sequence
  Description of Artificial Sequence: Synthetic oligonucleotide
gggugucaggaucugcuc

SEQ ID NO: 150760 - RNA, 18 nt, Artificial Sequence
  Description of Artificial Sequence: Synthetic oligonucleotide
cccaagggugucaggauc

SEQ ID NO: 150761 - RNA, 18 nt, Artificial Sequence
  Description of Artificial Sequence: Synthetic oligonucleotide
aaguccccaaggguguca

SEQ ID NO: 150762 - RNA, 17 nt, Artificial Sequence
  Description of Artificial Sequence: Synthetic oligonucleotide
gggcugcuggauguggg

SEQ ID NO: 150763 - RNA, 18 nt, Artificial Sequence
  Description of Artificial Sequence: Synthetic oligonucleotide
gggcugggccaggcccug

SEQ ID NO: 150764 - RNA, 18 nt, Artificial Sequence
  Description of Artificial Sequence: Synthetic oligonucleotide
gggccaggcccuggcccu

SEQ ID NO: 150765 - RNA, 18 nt, Artificial Sequence
  Description of Artificial Sequence: Synthetic oligonucleotide
aggcccuggcccugacgu

SEQ ID NO: 150766 - RNA, 18 nt, Artificial Sequence
  Description of Artificial Sequence: Synthetic oligonucleotide
cuggcccugacguggccu
